United States Patent 11,473,077 (ENGINEERED TYROSINE AMMONIA LYASE) - sequence listing, part 2

SEQ ID NO: 1969 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaactcgctgaccgatcgtttcccgacccacgcggagcagttcaaccaaaacatcaacagccagggttttggcagcgcgaacctgacccgtcaaagcattgaaatcttccagtactatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgctgatctggaacgacaacgagcaggcgctggatgaacacattgcgctgatcgcggaggatatcaccaaagatggccgtattgttcaggcgatcaaccaagtggttagcagt

SEQ ID NO: 1970 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQYYIAIALMFGVQSVDLRTKKIANHYDASQCLSPRTRQLYLAIKEVVGKAPSKDRPLIWNDNEQALDEHIALIAEDITKDGRIVQAINQVVSS

SEQ ID NO: 1971 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaagaagccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1972 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKKPSKDRPYIWNDNEQALDEHIALIAEDITKDGRIVQAINQVVSS

SEQ ID NO: 1973 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttacggtgcggaggcgcgcctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttcaccggcaacacgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1974 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAEARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFTGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1975 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacacgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggttcggcaccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1976 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNTLTDRFPTHAEQFNQNINSQGFGSANLTRQSIEIFQQYIAIALMFGVQSVDLRTKKIANHYDASQCLSPRTRQLYLAIKEVVGSAPSKDRPYIWNDNEQALDEHIALIAEDITKDGRIVQAINQVVSS

SEQ ID NO: 1977 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttacggtgcgaaggcgcgcctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttcctgggcaacacgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1978 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1979 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgtctgggtgcggaggcgagcctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacgcgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1980 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARLGAEASLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHAGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1981 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgcagccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacagccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcattgttaacatgggcctgaaggggctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1982 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELQPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRIVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1983 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtggccacgactaccgcggcgaacagccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcattgttaacatgggcctgaaggggctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1984 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGGHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRIVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1985 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacagccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcctggttaacatgggcctgaaggggctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1986 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRLVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1987 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1988 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1989 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccggcaacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1990 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPATRQLYLAIKEVVGKAPSKDRPYIWNDNEQALDEHIALIAEDITKDGRIVQAINQVVSS

SEQ ID NO: 1991 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaactcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1992 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNSSCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1993 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1994 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 1995 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1996 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1997 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgctaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccggcaacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgctgaaccaagtggttagcagt

SEQ ID NO: 1998 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNTLTDRFPTHAEQFNQNINSQGFGSANLTRQSIEIFQQYIAIALMFGVQSVDLRTKKIANHYDASQCLSPATRQLYLAIKEVVGKAPSKDRPYIWNDNEQALDEHIALIAEDITKDGRIVQALNQVVSS

SEQ ID NO: 1999 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaactcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgctaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2000 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNSSCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2001 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2002 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2003 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2004 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2005 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2006 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 2007 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgctaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccggcaacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2008 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNTLTDRFPTHAEQFNQNINSQGFGSANLTRQSIEIFQQYIAIALMFGVQSVDLRTKKIANHYDASQLLSPATRQLYLAIKEVVGKAPSKDRPYIWNDNEQALDEHIALIAEDITKDGRIVQAINQVVSS

SEQ ID NO: 2009 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaactcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgctaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccggcaacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgctgaaccaagtggttagcagt

SEQ ID NO: 2010 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNSSCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAIKEVVGKAPSKDRPYIWNDNEQALDEHIALIAEDITKDGRIVQALNQVVSS

SEQ ID NO: 2011 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaactcgagctgcgagtgggtggcgaccgcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgctaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccggcaacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgctgaaccaagtggttagcagt

SEQ ID NO: 2012 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNSSCEWVATAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQLLSPATRQLYLAIKEVVGKAPSKDRPYIWNDNEQALDEHIALIAEDITKDGRIVQALNQVVSS

SEQ ID NO: 2013 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgctaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccggcaacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2014 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNTLTDRFPTHAEQFNQNINSQGFGSANLTRQSIEIFQQYIAIALMFGVQSVDLRTKKIANHYDASQCLSPATRQLYLAIKEVVGKAPSKDRPYIWNDNEQALDEHIALIAEDITKDGRIVQAINQVVSS

SEQ ID NO: 2015 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgctaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2016 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2017 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 2018 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNTLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 2019 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaactcgagctgcgagtgggtggcgaccgcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgctaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 2020 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNSSCEWVATAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 2021 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaactcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2022 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNSSCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 2023 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttaaggtgggtgataagccgctgacgatcaatgaggtgtcggctgttgcgcgttatggtgcgaaggcgcgtctgaccgacaaagaggaagtgctgcagcgtgttaactcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgctaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccggcaacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 2024 - protein, 562 aa, Artificial Sequence
  Variant of Tyrosine Ammonia Lyase from Stanieria cyanosphaera
MIIASQTQTFTSKSPHTASDSVVKVGDKPLTINEVSAVARYGAKARLTDKEEVLQRVNSSCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPATRQLYLAIKEVVGKAPSKDRPYIWNDNEQALDEHIALIAEDITKDGRIVQAINQVVSS

SEQ ID NO: 2025 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgaccgcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2026 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVATAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2027 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttaaggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2028 - protein, 562 aa, Artificial Sequence
  Variant of Tyrosine Ammonia Lyase from Stanieria cyanosphaera
MIIASQTQTFTSKSPHTASDSVVKVGDKPLTINEVSAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2029 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2030 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2031 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttaaggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 2032 - protein, 562 aa, Artificial Sequence
  Variant of Tyrosine Ammonia Lyase from Stanieria cyanosphaera
MIIASQTQTFTSKSPHTASDSVVKVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2033 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttaaggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgctaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccggcaacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 2034 - protein, 562 aa, Artificial Sequence
  Variant of Tyrosine Ammonia Lyase from Stanieria cyanosphaera
MIIASQTQTFTSKSPHTASDSVVKVGDKPLTINEVSAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQLLSPATRQLYLAIKEVVGKAPSKDRPYIWNDNEQALDEHIALIAEDITKDGRIVQAINQVVSS

SEQ ID NO: 2035 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttaaggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2036 - protein, 562 aa, Artificial Sequence
  Variant of Tyrosine Ammonia Lyase from Stanieria cyanosphaera
MIIASQTQTFTSKSPHTASDSVVKVGDKPLTINEVSAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNTLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 2037 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccggcaacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgctgaaccaagtggttagcagt

SEQ ID NO: 2038 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPATRQLYLAIKEVVGKAPSKDRPYIWNDNEQALDEHIALIAEDITKDGRIVQALNQVVSS

SEQ ID NO: 2039 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcggtaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccggcaacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2040 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIGNQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNSLTDRFPTHAEQFNQNINSQGFGSANLTRQSIEIFQQYIAIALMFGVQSVDLRTKKIANHYDASQCLSPATRQLYLAIKEVVGKAPSKDRPYIWNDNEQALDEHIALIAEDITKDGRIVQAINQVVSS

SEQ ID NO: 2041 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgctaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccggcaacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2042 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQLLSPATRQLYLAIKEVVGKAPSKDRPYIWNDNEQALDEHIALIAEDITKDGRIVQAINQVVSS

SEQ ID NO: 2043 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcggtaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2044 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIGNQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNTLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 2045 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaactcgagctgcgagtgggtggcgaccgcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgctaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2046 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNSSCEWVATAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 2047 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaactcgagctgcgagtgggtggcgaccgcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgctaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccggcaacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2048 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNSSCEWVATAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNSLTDRFPTHAEQFNQNINSQGFGSANLTRQSIEIFQQYIAIALMFGVQSVDLRTKKIANHYDASQCLSPATRQLYLAIKEVVGKAPSKDRPYIWNDNEQALDEHIALIAEDITKDGRIVQAINQVVSS

SEQ ID NO: 2049 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttaaggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgctaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2050 - protein, 562 aa, Artificial Sequence
  Variant of Tyrosine Ammonia Lyase from Stanieria cyanosphaera
MIIASQTQTFTSKSPHTASDSVVKVGDKPLTINEVSAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2051 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaactcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2052 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNSSCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2053 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2054 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2055 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccggcaacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2056 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPATRQLYLAIKEVVGKAPSKDRPYIWNDNEQALDEHIALIAEDITKDGRIVQAINQVVSS

SEQ ID NO: 2057 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 2058 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2059 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttaaggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccggcaacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2060 - protein, 562 aa, Artificial Sequence
  Variant of Tyrosine Ammonia Lyase from Stanieria cyanosphaera
MIIASQTQTFTSKSPHTASDSVVKVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAIKEVVGKAPSKDRPYIWNDNEQALDEHIALIAEDITKDGRIVQAINQVVSS

SEQ ID NO: 2061 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaactcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 2062 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNSSCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2063 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacagtctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2064 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2065 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgcagccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtagcactccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2066 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELQPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGSTPSKDRPYIWNDNEQALDEHIALIAEDIGKDGRIVQAINQVVSS

SEQ ID NO: 2067 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgtcagggtgcgaaggcgcgtctgacggacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccaacaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2068 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARQGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDIGKDGRIVQAINQVVSS

SEQ ID NO: 2069 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgacggacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgcagccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaagctccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2070 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELQPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDIGKDGRIVQAINQVVSS

SEQ ID NO: 2071 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgtcagggtgcgaaggcgcgtctgacggacaaagcggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtctggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccaacaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaagctccgagcaaagatcgtccgtatatctggaacgacaacgagcaggcgctggatgaacacattgcgctgatcgtggaggatatcacgaaagatggccgtattgttcaggcgatcaaccaagtggttagcagt

SEQ ID NO: 2072 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARQGAKARLTDKAEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRLVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIVEDITKDGRIVQAINQVVSS

SEQ ID NO: 2073 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgacggacaaagcggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaaactccgagcaaagatcgtccgtatatctggaacgacaacgagcaggcgctggatgaacacattgcgctgatcgcggaggatatcacgaaagatggccgtattgttcaggcgatcaaccaagtggttagcagt

SEQ ID NO: 2074 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKAEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKTPSKDRPYIWNDNEQALDEHIALIAEDITKDGRIVQAINQVVSS

SEQ ID NO: 2075 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgacggacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaagctccgagcaaagatcgtccgtatatctggaacgacaacgagcaggcgctggatgaacacattgcgctgatcgcggaggatatcacgaaagatggccgtattgttcaggcgatcaaccaagtggttagcagt

SEQ ID NO: 2076 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2077 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgacggacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgcagccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2078 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELQPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDIGKDGRIVQAINQVVSS

SEQ ID NO: 2079 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgacggacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgcagccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaagctccgagcaaagatcgtccgtatatctggaacgacaacgagcaggcgctggatgaacacattgcgctgatcgcggaggatatcacgaaagatggccgtattgttcaggcgatcaaccaagtggttagcagt

SEQ ID NO: 2080 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELQPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2081 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgtcagggtgcgaaggcgcgtctgacggacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtagcactccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2082 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARQGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGSTPSKDRPYIWNDNEQALDEHIALIAEDIGKDGRIVQAINQVVSS

SEQ ID NO: 2083 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgtcagggtgcgaaggcgcgtctgacggacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtctggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtagcgctccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2084 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARQGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRLVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGSAPSKDRPYIWNDNEQALDEHIALIAEDIGKDGRIVQAINQVVSS

SEQ ID NO: 2085 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2086 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDIGKDGRIVQAINQVVSS

SEQ ID NO: 2087 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgcagccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtctggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccaacaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaaactccgagcaaagatcgtccgtatatctggaacgacaacgagcaggcgctggatgaacacattgcgctgatcgcggaggatatcacgaaagatggccgtattgttcaggcgatcaaccaagtggttagcagt

SEQ ID NO: 2088 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELQPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRLVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKTPSKDRPYIWNDNEQALDEHIALIAEDITKDGRIVQAINQVVSS

SEQ ID NO: 2089 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgtcagggtgcgcctgcgcgtctgacggacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccaacaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaagctccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2090 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARQGAPARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDIGKDGRIVQAINQVVSS

SEQ ID NO: 2091 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgcgtgcgcgtctgacggacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccaacaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtagcgctccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2092 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGARARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGSAPSKDRPYIWNDNEQALDEHIALIAEDIGKDGRIVQAINQVVSS

SEQ ID NO: 2093 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgtcagggtgcgaaggcgcgtctgacggacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtctggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccaacaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaagctccgagcaaagatcgtccgtatatctggaacgacaacgagcaggcgctggatgaacacattgcgctgatcgtggaggatatcggtaaagatggccgtattgttcaggcgatcaaccaagtggttagcagt

SEQ ID NO: 2094 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARQGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRLVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIVEDIGKDGRIVQAINQVVSS

SEQ ID NO: 2095 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgtcagggtgcgaaggcgcgtctgacggacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtctggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccaacaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtagcgctccgagcaaagatcgtccgtatatctggaacgacaacgagcaggcgctggatgaacacattgcgctgatcgtggaggatatcacgaaagatggccgtattgttcaggcgatcaaccaagtggttagcagt

SEQ ID NO: 2096 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARQGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRLVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGSAPSKDRPYIWNDNEQALDEHIALIVEDITKDGRIVQAINQVVSS

SEQ ID NO: 2097 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgacggacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccaacaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaaactccgagcaaagatcgtccgtatatctggaacgacaacgagcaggcgctggatgaacacattgcgctgatcgcggaggatatcacgaaagatggccgtattgttcaggcgatcaaccaagtggttagcagt

SEQ ID NO: 2098 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKTPSKDRPYIWNDNEQALDEHIALIAEDITKDGRIVQAINQVVSS

SEQ ID NO: 2099 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtctggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaagctccgagcaaagatcgtccgtatatctggaacgacaacgagcaggcgctggatgaacacattgcgctgatcgcggaggatatcacgaaagatggccgtattgttcaggcgatcaaccaagtggttagcagt

SEQ ID NO: 2100 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRLVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2101 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgtcagggtgcgaaggcgcgtctgacggacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgtggaggatatcacgaaagatggccgtattgttcaggcgatcaaccaagtggttagcagt

SEQ ID NO: 2102 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARQGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIVEDITKDGRIVQAINQVVSS

SEQ ID NO: 2103 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcatgggtgcccatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgatccgcgaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2104 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSMGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIREVVGKAPSKDRPYIWNDNEQALDEHIALIAEDITKDGRIVQAINQVVSS

SEQ ID NO: 2105 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcccatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactattaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtccgcgaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2106 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTITDRFPTHAEQFNQNINSQGFGSANLTRQSIEIFQQYIAIALMFGVQSVDLRTKKIANHYDASQCLSPRTRQLYLAVREVVGKAPSKDRPYIWNDNEQALDEHIALIAEDITKDGRIVQAINQVVSS

SEQ ID NO: 2107 - DNA, 1686 bp, Artificial Sequence
  Variant of Tyrosine Ammonia Lyase from Stanieria cyanosphaera
atgatcattgcgagccagacccaaaccttcaccagccaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcccatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2108 - protein, 562 aa, Artificial Sequence
  Variant of Tyrosine Ammonia Lyase from Stanieria cyanosphaera
MIIASQTQTFTSQSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2109 - DNA, 1686 bp, Artificial Sequence
  Variant of Tyrosine Ammonia Lyase from Stanieria cyanosphaera
atgatcattgcgagccagacccaaaccttcaccagcagtagtccgcacaccgccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcccatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2110 - protein, 562 aa, Artificial Sequence
  Variant of Tyrosine Ammonia Lyase from Stanieria cyanosphaera
MIIASQTQTFTSSSPHTASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2111 - DNA, 1686 bp, Artificial Sequence
  Variant of Tyrosine Ammonia Lyase from Stanieria cyanosphaera
atgatcattgcgagccagacccaaaccttcaccagcagtagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcccatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgatcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2112 - protein, 562 aa, Artificial Sequence
  Variant of Tyrosine Ammonia Lyase from Stanieria cyanosphaera
MIIASQTQTFTSSSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2113 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2114 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2115 - DNA, 1686 bp, Artificial Sequence
  Variant of Tyrosine Ammonia Lyase from Stanieria cyanosphaera
atgatcattgcgagccagaccgataccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2116 - protein, 562 aa, Artificial Sequence
  Variant of Tyrosine Ammonia Lyase from Stanieria cyanosphaera
MIIASQTDTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2117 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccggtgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2118 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPVLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2119 - DNA, 1686 bp, Artificial Sequence
  Variant of Tyrosine Ammonia Lyase from Stanieria cyanosphaera
atgatcattgcgagccagacccaaaccttcgggagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2120 - protein, 562 aa, Artificial Sequence
  Variant of Tyrosine Ammonia Lyase from Stanieria cyanosphaera
MIIASQTQTFGSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2121 - DNA, 1686 bp, Artificial Sequence
  Variant of Tyrosine Ammonia Lyase from Stanieria cyanosphaera
atgatcattgatagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2122 - protein, 562 aa, Artificial Sequence
  Variant of Tyrosine Ammonia Lyase from Stanieria cyanosphaera
MIIDSQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2123 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2124 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2125 - DNA, 1686 bp, Artificial Sequence
  Variant of Tyrosine Ammonia Lyase from Stanieria cyanosphaera
atgatcattgcgagccagacccaaaccttcaccagcaaaagtccgcaccaggccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2126 - protein, 562 aa, Artificial Sequence
  Variant of Tyrosine Ammonia Lyase from Stanieria cyanosphaera
MIIASQTQTFTSKSPHQASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2127 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcggttcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2128 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALAVQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2129 - DNA, 1686 bp, Artificial Sequence
  Variant of Tyrosine Ammonia Lyase from Stanieria cyanosphaera
atgatcattgcgagccagacccaaaccttcgatagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2130 - protein, 562 aa, Artificial Sequence
  Variant of Tyrosine Ammonia Lyase from Stanieria cyanosphaera
MIIASQTQTFDSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2131 - DNA, 1686 bp, Artificial Sequence
  Variant of Tyrosine Ammonia Lyase from Stanieria cyanosphaera
atgatcattgcgagccagacccaaaccttcaccagcaggagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2132 - protein, 562 aa, Artificial Sequence
  Variant of Tyrosine Ammonia Lyase from Stanieria cyanosphaera
MIIASQTQTFTSRSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2133 - DNA, 1686 bp, Artificial Sequence
  Variant of Tyrosine Ammonia Lyase from Stanieria cyanosphaera
atgatcattgcgagccagacccaaaccttcgcgagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2134 - protein, 562 aa, Artificial Sequence
  Variant of Tyrosine Ammonia Lyase from Stanieria cyanosphaera
MIIASQTQTFASKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2135 - DNA, 1686 bp, Artificial Sequence
  Variant of Tyrosine Ammonia Lyase from Stanieria cyanosphaera
atgatcattgcgagccagacccaaaccttcagtagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2136 - protein, 562 aa, Artificial Sequence
  Variant of Tyrosine Ammonia Lyase from Stanieria cyanosphaera
MIIASQTQTFSSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2137 - DNA, 1686 bp, Artificial Sequence
  Variant of Tyrosine Ammonia Lyase from Stanieria cyanosphaera
atgatcattgcgagccagacccgtaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2138 - protein, 562 aa, Artificial Sequence
  Variant of Tyrosine Ammonia Lyase from Stanieria cyanosphaera
MIIASQTRTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2139 - DNA, 1686 bp, Artificial Sequence
  Variant of Tyrosine Ammonia Lyase from Stanieria cyanosphaera
atgatcattgcgagccagacccaaaccttcaagagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2140 - protein, 562 aa, Artificial Sequence
  Variant of Tyrosine Ammonia Lyase from Stanieria cyanosphaera
MIIASQTQTFKSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2141 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgcgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2142 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSATDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2143 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgcccatgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2144 - protein, 562 aa, Artificial Sequence
  Variant of Tyrosine Ammonia Lyase from Stanieria cyanosphaera
MIIASQTQTFTSKSPHTAHDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2145 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattagggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2146 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIRDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2147 - DNA, 1686 bp, Artificial Sequence
  Variant of Tyrosine Ammonia Lyase from Stanieria cyanosphaera
atgatcattgcgagccagaccgggaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2148 - protein, 562 aa, Artificial Sequence
  Variant of Tyrosine Ammonia Lyase from Stanieria cyanosphaera
MIIASQTGTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2149 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtcttgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2150 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRLETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2151 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcggacggtatggcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2152 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGMAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 2153 - DNA, 1686 bp, Artificial Sequence
  Variant of Tyrosine Ammonia Lyase from Stanieria cyanosphaera
atgatcattgctagccagaccgataccttcgacagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgccgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2154 - protein, 562 aa, Artificial Sequence
  Variant of Tyrosine Ammonia Lyase from Stanieria cyanosphaera
MIIASQTDTFDSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKAPSKDRPYIWNDNEQALDEHIALIAEDITKDGRIVQAINQVVSS

SEQ ID NO: 2155 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2156 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2157 - DNA, 1686 bp, Artificial Sequence
  Variant of Tyrosine Ammonia Lyase from Stanieria cyanosphaera
atgatcattgatagccagacccagaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgccgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgtacccgccaactgtatctggcggtcaaggaagtggttggtaaggcgccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2158 - protein, 562 aa, Artificial Sequence
  Variant of Tyrosine Ammonia Lyase from Stanieria cyanosphaera
MIIDSQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2159 - DNA, 1686 bp, Artificial Sequence
  Variant of Tyrosine Ammonia Lyase from Stanieria cyanosphaera
atgatcattgatagccagacccagaccttcactagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgccgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccggtgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgtacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2160 - protein, 562 aa, Artificial Sequence
  Variant of Tyrosine Ammonia Lyase from Stanieria cyanosphaera
MIIDSQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPVLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2161 - DNA, 1686 bp, Artificial Sequence
  Variant of Tyrosine Ammonia Lyase from Stanieria cyanosphaera
atgatcattgatagccagacccgtaccttcgacagccgtagtccgcacaccgccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgccgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2162 - protein, 562 aa, Artificial Sequence
  Variant of Tyrosine Ammonia Lyase from Stanieria cyanosphaera
MIIDSQTRTFDSRSPHTASDSTVTVGDKPLTINEVSAVARYGAKVRLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKAPSKDRPYIWNDNEQALDEHIALIAEDITKDGRIVQAINQVVSS

SEQ ID NO: 2163 - DNA, 1686 bp, Artificial Sequence
  Variant of Tyrosine Ammonia Lyase from Stanieria cyanosphaera
atgatcattgatagccagacccagaccttcactagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgtacccgccaactgtatctggcggtcaaggaagtggttggtaaggctccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2164 - protein, 562 aa, Artificial Sequence
  Variant of Tyrosine Ammonia Lyase from Stanieria cyanosphaera
MIIDSQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2165 - DNA, 1686 bp, Artificial Sequence
  Variant of Tyrosine Ammonia Lyase from Stanieria cyanosphaera
atgatcattgcgagccagacccagaccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgtacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2166 - protein, 562 aa, Artificial Sequence
  Variant of Tyrosine Ammonia Lyase from Stanieria cyanosphaera
MIIASQTQTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2167 - DNA, 1686 bp, Artificial Sequence
  Variant of Tyrosine Ammonia Lyase from Stanieria cyanosphaera
atgatcattgatagccagaccgataccttcggtagcaaaagtccgcaccccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccggtgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaaggctccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2168 - protein, 562 aa, Artificial Sequence
  Variant of Tyrosine Ammonia Lyase from Stanieria cyanosphaera
MIIDSQTDTFGSKSPHPASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPVLTFLGNTLTDRFPTHAEQFNQNINSQGFGSANLTRQSIEIFQQYIAIALMFGVQSVDLRTKKIANHYDASQCLSPATRQLYLAVKEVVGKAPSKDRPYIWNDNEQALDEHIALIAEDITKDGRIVQAINQVVSS

SEQ ID NO: 2169 - DNA, 1686 bp, Artificial Sequence
  Variant of Tyrosine Ammonia Lyase from Stanieria cyanosphaera
atgatcattgatagccagaccgataccttcactagcaaaagtccgcacaccgccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgccgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2170 - protein, 562 aa, Artificial Sequence
  Variant of Tyrosine Ammonia Lyase from Stanieria cyanosphaera
MIIDSQTDTFTSKSPHTASDSTVTVGDKPLTINEVSAVARYGAKVRLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKAPSKDRPYIWNDNEQALDEHIALIAEDITKDGRIVQAINQVVSS

SEQ ID NO: 2171 - DNA, 1686 bp, Artificial Sequence
  Variant of Tyrosine Ammonia Lyase from Stanieria cyanosphaera
atgatcattgatagccagacccagaccttcactagcaaaagtccgcaccaggccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctgtcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgccgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgtacccgccaactgtatctggcggtcaaggaagtggttggtaagactccgagcaaagatcgtccgtatatctggaacgacaacgagcaggcgctggatgaacacattgcgctgatcgcggaggatatcgctaaagatggccgtattgttcaggcgatcaaccaagtggttagcagt

SEQ ID NO: 2172 - protein, 562 aa, Artificial Sequence
  Variant of Tyrosine Ammonia Lyase from Stanieria cyanosphaera
MIIDSQTQTFTSKSPHQASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLSLSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKTPSKDRPYIWNDNEQALDEHIALIAEDIAKDGRIVQAINQVVSS

SEQ ID NO: 2173 - DNA, 1686 bp, Artificial Sequence
  Variant of Tyrosine Ammonia Lyase from Stanieria cyanosphaera
atgatcattgctagccagacccagaccttcggcagccgtagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgccgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaaggctccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2174 - protein, 562 aa, Artificial Sequence
  Variant of Tyrosine Ammonia Lyase from Stanieria cyanosphaera
MIIASQTQTFGSRSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKAPSKDRPYIWNDNEQALDEHIALIAEDITKDGRIVQAINQVVSS

SEQ ID NO: 2175 - DNA, 1686 bp, Artificial Sequence
  Variant of Tyrosine Ammonia Lyase from Stanieria cyanosphaera
atgatcattgctagccagaccgataccttcgacagccgtagtccgcacactgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgtacccgccaactgtatctggcggtcaaggaagtggttggtaaggctccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2176 - protein, 562 aa, Artificial Sequence
  Variant of Tyrosine Ammonia Lyase from Stanieria cyanosphaera
MIIASQTDTFDSRSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2177 - DNA, 1686 bp, Artificial Sequence
  Variant of Tyrosine Ammonia Lyase from Stanieria cyanosphaera
atgatcattgatagccagacccgtaccttcgacagcaaaagtccgcacaccgccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgccgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2178 - protein, 562 aa, Artificial Sequence
  Variant of Tyrosine Ammonia Lyase from Stanieria cyanosphaera
MIIDSQTRTFDSKSPHTASDSTVTVGDKPLTINEVSAVARYGAKVRLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2179 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgtgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2180 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDVQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2181 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtatggcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2182 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGMAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2183 - DNA, 1686 bp, Artificial Sequence
  Variant of Tyrosine Ammonia Lyase from Stanieria cyanosphaera
atgatcattgcgagccagacccaaaccttcaccagcaaaagtccgcagaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2184 - protein, 562 aa, Artificial Sequence
  Variant of Tyrosine Ammonia Lyase from Stanieria cyanosphaera
MIIASQTQTFTSKSPQTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2185 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggggatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2186 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLGDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2187 - DNA, 1686 bp, Artificial Sequence
  Variant of Tyrosine Ammonia Lyase from Stanieria cyanosphaera
atgatcattgcgagccagacccaaaccgggaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2188 - protein, 562 aa, Artificial Sequence
  Variant of Tyrosine Ammonia Lyase from Stanieria cyanosphaera
MIIASQTQTGTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2189 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcacgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2190 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCTPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2191 - DNA, 1686 bp, Artificial Sequence
  Variant of Tyrosine Ammonia Lyase from Stanieria cyanosphaera
atgacgattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2192 - protein, 562 aa, Artificial Sequence
  Variant of Tyrosine Ammonia Lyase from Stanieria cyanosphaera
MTIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2193 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtatggcggcgaactgcgtttatgatgcgcagaacctgctggcgctgagcctgggggcccatgcgctggcgctgcagggcctgaacggtaccaaccatagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2194 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGMAANCVYDAQNLLALSLGAHALALQGLNGTNHSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2195 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagaaccgaaccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcgttatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2196 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEEPNQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSVMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2197 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgcgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2198 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDAQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2199 - DNA, 1686 bp, Artificial Sequence
  Variant of Tyrosine Ammonia Lyase from Stanieria cyanosphaera
atgatcattgcgagccagcagcaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2200 - protein, 562 aa, Artificial Sequence
  Variant of Tyrosine Ammonia Lyase from Stanieria cyanosphaera
MIIASQQQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2201 - DNA, 1686 bp, Artificial Sequence
  Variant of Tyrosine Ammonia Lyase from Stanieria cyanosphaera
atggggattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2202 - protein, 562 aa, Artificial Sequence
  Variant of Tyrosine Ammonia Lyase from Stanieria cyanosphaera
MGIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2203 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctggagttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2204 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLEFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2205 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgttgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2206 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALLFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2207 - DNA, 1686 bp, Artificial Sequence
  Variant of Tyrosine Ammonia Lyase from Stanieria cyanosphaera
atgatcattgcgagcgggacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2208 - protein, 562 aa, Artificial Sequence
  Variant of Tyrosine Ammonia Lyase from Stanieria cyanosphaera
MIIASGTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2209 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtattaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2210 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRINASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2211 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgtttcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2212 - protein, 562 aa, Artificial Sequence
  Variant of Tyrosine Ammonia Lyase from Stanieria cyanosphaera
MIIASQTQTFTSKSPHTASDSVVTVGDKPLTINEVSAVSRYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2213 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcgttatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2214 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSVMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2215 - DNA, 1686 bp, Artificial Sequence
  Variant of Tyrosine Ammonia Lyase from Stanieria cyanosphaera
atgatcattgcgagccagacccaaaccttcaccagcaaaagtccgacgaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2216 - protein, 562 aa, Artificial Sequence
  Variant of Tyrosine Ammonia Lyase from Stanieria cyanosphaera
MIIASQTQTFTSKSPTTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2217 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgctctcgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2218 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRSRQLYLAVKEVVGKAPSKDRPYIWNDNEQALDEHIALIAEDITKDGRIVQAINQVVSS

SEQ ID NO: 2219 - DNA, 1686 bp, Artificial Sequence
  Variant of Tyrosine Ammonia Lyase from Stanieria cyanosphaera
atgatcattgcgagccagacccaaaccttcaccagcaaagggccgcacaccgccagcgacagcgtggttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgcagacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcggtcaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 2220 - protein, 562 aa, Artificial Sequence
  Variant of Tyrosine Ammonia Lyase from Stanieria cyanosphaera
MIIASQTQTFTSKGPHTASDSVVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAVKEVVGKAPSKDRPYIWNDNEQALDEHIALIAEDITKDGRIVQAINQVVSS

SEQ ID NO: 2221 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttacggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtattgaaaccttcctgaacgcaggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgctgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2222 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALLFGVQSVDLRTKKIANHYDASQCLSPATRQLYLAVKEVVGKTPSKDRPYIWNDNEQALDEHIALIAEDITKDGRIVQAINQVVSS

SEQ ID NO: 2223 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcaggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctgtcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgcccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgctgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2224 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLSLSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDAQIALLTMPEFNNGLPASLVGNTDRMVNMGLKGLQITGNSIMPLLTFLGNTLTDRFPTHAEQFNQNINSQGFGSANLTRQSIEIFQQYIAIALLFGVQSVDLRTKKIANHYDASQCLSPATRQLYLAVKEVVGKTPSKDRPYIWNDNEQALDEHIALIAEDITKDGRIVQAINQVVSS

SEQ ID NO: 2225 - DNA, 1686 bp, Artificial Sequence
  Variant of Tyrosine Ammonia Lyase from Stanieria cyanosphaera
atgatcattgctagccagaccgataccttcgacagcaaaagtccgcaacaggccagcgacagcaccgttacggtgggtgataagccgctgacgatcaatgaggtgtcggctgttgcgcgttacggtgcgaaggttcgtctgaccgacaaagaggaagtgctgcagcgtattaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcaggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgactgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2226 - protein, 562 aa, Artificial Sequence
  Variant of Tyrosine Ammonia Lyase from Stanieria cyanosphaera
MIIASQTDTFDSKSPQQASDSTVTVGDKPLTINEVSAVARYGAKVRLTDKEEVLQRINASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2227 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtattaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgtcgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgactgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2228 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRINASCEWVAQAVAKGEPIYGVTTGFGGMANVVITPDQAKELQNNLPRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2229 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttacggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcaggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2230 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLGDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2231 - DNA, 1686 bp, Artificial Sequence
  Variant of Tyrosine Ammonia Lyase from Stanieria cyanosphaera
atgatcattgctagccagaccgataccttcgacagcaaaagtccgcaacaggccagcgacagcaccgttacggtgggtgataagccgctgacgatcaatgaggtgtcggctgttgcgcgttacggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgcccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgactgatcgtttcccgacccacgcggagcagttcaaccaaaacatcaacagccagggttttggcagcgcgaacctgacccgtcaaagcattgaaatcttccagcaatatattgcgatcgcgctgctgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2232 - protein, 562 aa, Artificial Sequence
  Variant of Tyrosine Ammonia Lyase from Stanieria cyanosphaera
MIIASQTDTFDSKSPQQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDAQIALLTMPEFNNGLPASLVGNTDRMVNMGLKGLQITGNSIMPLLTFLGNTLTDRFPTHAEQFNQNINSQGFGSANLTRQSIEIFQQYIAIALLFGVQSVDLRTKKIANHYDASQCLSPATRQLYLAVKEVVGKTPSKDRPYIWNDNEQALDEHIALIAEDIGKDGRIVQAINQVVSS

SEQ ID NO: 2233 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctgtcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgcccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgactgatcgtttcccgacccacgcggagcagttcaaccaaaacatcaacagccagggttttggcagcgcgaacctgacccgtcaaagcattgaaatcttccagcaatatattgcgatcgcgctgctgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2234 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLSLSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDAQIALLTMPEFNNGLPASLVGNTDRMVNMGLKGLQITGNSIMPLLTFLGNTLTDRFPTHAEQFNQNINSQGFGSANLTRQSIEIFQQYIAIALLFGVQSVDLRTKKIANHYDASQCLSPATRQLYLAVKEVVGKTPSKDRPYIWNDNEQALDEHIALIAEDIGKDGRIVQAINQVVSS

SEQ ID NO: 2235 - DNA, 1686 bp, Artificial Sequence
  Variant of Tyrosine Ammonia Lyase from Stanieria cyanosphaera
atgatcattgctagccagaccgataccttcgacagcaaaagtccgcaacaggccagcgacagcaccgttacggtgggtgataagccgctgacgatcaatgaggtgtcggctgttgcgcgttacggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcaggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgcccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2236 - protein, 562 aa, Artificial Sequence
  Variant of Tyrosine Ammonia Lyase from Stanieria cyanosphaera
MIIASQTDTFDSKSPQQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDAQIALLTMPEFNNGLPASLVGNTDRMVNMGLKGLQITGNSIMPLLTFLGNTLGDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2237 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctgtcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgctgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2238 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLSLSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLGDRFPTHAEQFNQNINSQGFGSANLTRQSIEIFQQYIAIALLFGVQSVDLRTKKIANHYDASQCLSPATRQLYLAVKEVVGKTPSKDRPYIWNDNEQALDEHIALIAEDITKDGRIVQAINQVVSS

SEQ ID NO: 2239 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcaggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctgtcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgcccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgactgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2240 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLSLSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDAQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2241 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcggcagcaccgttacggtgggtgataagccgctgacgatcaatgaggtgtcggctgttgcgcgttacggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcaggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgcccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgctgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2242 - protein, 562 aa, Artificial Sequence
  Variant of Tyrosine Ammonia Lyase from Stanieria cyanosphaera
MIIASQTDTFDSKSPHQASGSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDAQIALLTMPEFNNGLPASLVGNTDRMVNMGLKGLQITGNSIMPLLTFLGNTLGDRFPTHAEQFNQNINSQGFGSANLTRQSIEIFQQYIAIALLFGVQSVDLRTKKIANHYDASQCLSPATRQLYLAVKEVVGKTPSKDRPYIWNDNEQALDEHIALIAEDIGKDGRIVQAINQVVSS

SEQ ID NO: 2243 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtattaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgactgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2244 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRINASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2245 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcaggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgcccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2246 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDAQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2247 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcaggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgcccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgctgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2248 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDAQIALLTMPEFNNGLPASLVGNTDRMVNMGLKGLQITGNSIMPLLTFLGNTLGDRFPTHAEQFNQNINSQGFGSANLTRQSIEIFQQYIAIALLFGVQSVDLRTKKIANHYDASQCLSPATRQLYLAVKEVVGKTPSKDRPYIWNDNEQALDEHIALIAEDIGKDGRIVQAINQVVSS

SEQ ID NO: 2249 - DNA, 1686 bp, Artificial Sequence
  Variant of Tyrosine Ammonia Lyase from Stanieria cyanosphaera
atgatcattgctagccagaccgataccttcgacagcaaaagtccgcaacaggccagcgacagcaccgttacggtgggtgataagccgctgacgatcaatgaggtgtcggctgttgcgcgttacggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctgtcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2250 - protein, 562 aa, Artificial Sequence
  Variant of Tyrosine Ammonia Lyase from Stanieria cyanosphaera
MIIASQTDTFDSKSPQQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLSLSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLGDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2251 - DNA, 1686 bp, Artificial Sequence
  Variant of Tyrosine Ammonia Lyase from Stanieria cyanosphaera
atgatcattgctagccagaccgataccttcgacagcaaaagtccgcaacaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgactgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2252 - protein, 562 aa, Artificial Sequence
  Variant of Tyrosine Ammonia Lyase from Stanieria cyanosphaera
MIIASQTDTFDSKSPQQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2253 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctgtcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2254 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLSLSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLGDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2255 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttacggtgcgaaggttcgtctgaccgacaaagaggaagtgctgcagcgtattaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2256 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRINASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLGDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2257 - DNA, 1686 bp, Artificial Sequence
  Variant of Tyrosine Ammonia Lyase from Stanieria cyanosphaera
atgatcattgctagccagaccgataccttcgacagcaaaagtccgcaacaggccagcgacagcaccgttacggtgggtgataagccgctgacgatcaatgaggtgtcggctgttgcgcgttacggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgcccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgactgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2258 - protein, 562 aa, Artificial Sequence
  Variant of Tyrosine Ammonia Lyase from Stanieria cyanosphaera
MIIASQTDTFDSKSPQQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDAQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2259 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttacggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgctgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2260 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLGDRFPTHAEQFNQNINSQGFGSANLTRQSIEIFQQYIAIALLFGVQSVDLRTKKIANHYDASQCLSPATRQLYLAVKEVVGKTPSKDRPYIWNDNEQALDEHIALIAEDITKDGRIVQAINQVVSS

SEQ ID NO: 2261 - DNA, 1686 bp, Artificial Sequence
  Variant of Tyrosine Ammonia Lyase from Stanieria cyanosphaera
atgatcattgatagccagaccgataccttcgacagcaaaagtccgcaacaggccagcgacagcaccgttacggtgggtgataagccgctgacgatcaatgaggtgtcggctgttgcgcgttacggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgcccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgactgatcgtttcccgacccacgcggagcagttcaaccaaaacatcaacagccagggttttggcagcgcgaacctgacccgtcaaagcattgaaatcttccagcaatatattgcgatcgcgctgctgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2262 - protein, 562 aa, Artificial Sequence
  Variant of Tyrosine Ammonia Lyase from Stanieria cyanosphaera
MIIDSQTDTFDSKSPQQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDAQIALLTMPEFNNGLPASLVGNTDRMVNMGLKGLQITGNSIMPLLTFLGNTLTDRFPTHAEQFNQNINSQGFGSANLTRQSIEIFQQYIAIALLFGVQSVDLRTKKIANHYDASQCLSPATRQLYLAVKEVVGKTPSKDRPYIWNDNEQALDEHIALIAEDITKDGRIVQAINQVVSS

SEQ ID NO: 2263 - DNA, 1686 bp, Artificial Sequence
  Variant of Tyrosine Ammonia Lyase from Stanieria cyanosphaera
atgattattgatagccagacggataccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtattaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2264 - protein, 562 aa, Artificial Sequence
  Variant of Tyrosine Ammonia Lyase from Stanieria cyanosphaera
MIIDSQTDTFDSKSPHQASDSTVTVGDKPLTINEVSAVARYGAKVRLTDKEEVLQRINASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLGDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2265 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgtcgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 2266 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 2267 - DNA, 1686 bp, Artificial Sequence
  Variant of Tyrosine Ammonia Lyase from Stanieria cyanosphaera
atgatcattgctagccagaccgataccttcgacagcaaaagtccgcaacaggccagcgacagcaccgttacggtgggtgataagccgctgacgatcaatgaggtgtcggctgttgcgcgtcagggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2268 - protein, 562 aa, Artificial Sequence
  Variant of Tyrosine Ammonia Lyase from Stanieria cyanosphaera
MIIASQTDTFDSKSPQQASDSTVTVGDKPLTINEVSAVARQGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLGDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2269 - DNA, 1686 bp, Artificial Sequence
  Variant of Tyrosine Ammonia Lyase from Stanieria cyanosphaera
atgattattgctagccagacggataccggggacagcaaaagtccgcaacaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcaggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2270 - protein, 562 aa, Artificial Sequence
  Variant of Tyrosine Ammonia Lyase from Stanieria cyanosphaera
MIIASQTDTGDSKSPQQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLGDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2271 - DNA, 1686 bp, Artificial Sequence
  Variant of Tyrosine Ammonia Lyase from Stanieria cyanosphaera
atgattattgatagccagcaggataccttcgacagcaaaagtccgcaccaggccagcgacagcaccgttacggtgggtgataagccgctgacgatcaatgaggtgtcggctgttgcgcgttacggtgcgaaggttcgtctgaccgacaaagaggaagtgctgcagcgtattaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgactgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2272 - protein, 562 aa, Artificial Sequence
  Variant of Tyrosine Ammonia Lyase from Stanieria cyanosphaera
MIIDSQQDTFDSKSPHQASDSTVTVGDKPLTINEVSAVARYGAKVRLTDKEEVLQRINASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2273 - DNA, 1686 bp, Artificial Sequence
  Variant of Tyrosine Ammonia Lyase from Stanieria cyanosphaera
atgattattgctagccagcaggataccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgcccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2274 - protein, 562 aa, Artificial Sequence
  Variant of Tyrosine Ammonia Lyase from Stanieria cyanosphaera
MIIASQQDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDAQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDIGKDGRIVQAINQVVSS

SEQ ID NO: 2275 - DNA, 1686 bp, Artificial Sequence
  Variant of Tyrosine Ammonia Lyase from Stanieria cyanosphaera
atgatcattgctagccagaccgataccttcgacagcaaaagtccgcaacaggccagcgacagcaccgttacggtgggtgataagccgctgacgatcaatgaggtgtcggctgttgcgcgtcagggtgcgaaggttcgtctgaccgacaaagaggaagtgctgcagcgtattaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcaggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgctgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2276 - protein, 562 aa, Artificial Sequence
  Variant of Tyrosine Ammonia Lyase from Stanieria cyanosphaera
MIIASQTDTFDSKSPQQASDSTVTVGDKPLTINEVSAVARQGAKVRLTDKEEVLQRINASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLGDRFPTHAEQFNQNINSQGFGSANLTRQSIEIFQQYIAIALLFGVQSVDLRTKKIANHYDASQCLSPATRQLYLAVKEVVGKTPSKDRPYIWNDNEQALDEHIALIAEDITKDGRIVQAINQVVSS

SEQ ID NO: 2277 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgactgatcgtttcccgacccacgcggagcagttcaaccaaaacatcaacagccagggttttggcagcgcgaacctgacccgtcaaagcattgaaatcttccagcaatatattgcgatcgcgctgctgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2278 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALLFGVQSVDLRTKKIANHYDASQCLSPATRQLYLAVKEVVGKTPSKDRPYIWNDNEQALDEHIALIAEDITKDGRIVQAINQVVSS

SEQ ID NO: 2279 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttacggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctgtcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgactgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2280 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLSLSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2281 - DNA, 1686 bp, Artificial Sequence
  Variant of Tyrosine Ammonia Lyase from Stanieria cyanosphaera
atgatcattgctagccagaccgataccttcgacagcaaaagtccgcaacaggccagcgacagcaccgttacggtgggtgataagccgctgacgatcaatgaggtgtcggctgttgcgcgtcagggtgcgaaggttcgtctgaccgacaaagaggaagtgctgcagcgtattaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgcccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgactgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2282 - protein, 562 aa, Artificial Sequence
  Variant of Tyrosine Ammonia Lyase from Stanieria cyanosphaera
MIIASQTDTFDSKSPQQASDSTVTVGDKPLTINEVSAVARQGAKVRLTDKEEVLQRINASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDAQIALLTMPEFNNGLPASLVGNTDRMVNMGLKGLQITGNSIMPLLTFLGNTLTDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDIGKDGRIVQAINQVVSS

SEQ ID NO: 2283 - DNA, 1686 bp, Artificial Sequence
  Variant of Tyrosine Ammonia Lyase from Stanieria cyanosphaera
atgatcattgctagccagaccgataccttcgacagcaaaagtccgcaacaggccagcgacagcaccgttacggtgggtgataagccgctgacgatcaatgaggtgtcggctgttgcgcgttatggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcaggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2284 - protein, 562 aa, Artificial Sequence
  Variant of Tyrosine Ammonia Lyase from Stanieria cyanosphaera
MIIASQTDTFDSKSPQQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLGDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS

SEQ ID NO: 2285 - DNA, 1686 bp, Artificial Sequence
  Variant of Tyrosine Ammonia Lyase from Stanieria cyanosphaera
atgattattgatagccagcaggataccttcgacagcaaaagtccgcaccaggccagcgacagcaccgttacggtgggtgataagccgctgacgatcaatgaggtgtcggctgttgcgcgttacggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgtcgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2286 - protein, 562 aa, Artificial Sequence
  Variant of Tyrosine Ammonia Lyase from Stanieria cyanosphaera
MIIDSQQDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLGDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDIGKDGRIVQAINQVVSS

SEQ ID NO: 2287 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttacggtgcgaaggttcgtctgaccgacaaagaggaagtgctgcagcgtattaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtattgaaaccttcctgaacgcaggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgactgatcgtttcccgacccacgcggagcagttcaaccaaaacatcaacagccagggttttggcagcgcgaacctgacccgtcaaagcattgaaatcttccagcaatatattgcgatcgcgctgctgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcggtaaagatggccgtattgttcaggcgatcaaccaagtggttagcagt

SEQ ID NO: 2288 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRINASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFLGNTLTDRFPTHAEQFNQNINSQGFGSANLTRQSIEIFQQYIAIALLFGVQSVDLRTKKIANHYDASQCLSPATRQLYLAVKEVVGKTPSKDRPYIWNDNEQALDEHIALIAEDIGKDGRIVQAINQVVSS

SEQ ID NO: 2289 - DNA, 1686 bp, Artificial Sequence
  Variant of Tyrosine Ammonia Lyase from Stanieria cyanosphaera
atgatcattgctagccagaccgataccttcgacagcaaaagtccgcaccaggccagcgacagcaccgttacggtgggtgataagccgctgacgatcaatgaggtgtcggctgttgcgcgttacggtgcgaaggttcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtattgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagcctgctgatccgtgacgagctggatggtagccacgactaccgcggcgaagatccgatccaagatcgttacagcatgcgttgcctgccgcagtataccggcccgattgtcgacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgcccaaatcgcgctgctgaccatgccggagtttaacaacggtctgccggctagcctggtgggtaacaccgaccgcatggttaacatgggcctgaagggtctgcagattaccggtaacagcatcatgccgctgctgaccttcctgggcaacactctgggtgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccggccacccgccaactgtatctggcggtcaaggaagtggttggtaagactccgagcaaagatcgtccgtatatctggaacgacaacgagcaggcgctggatgaacacattgcgctgatcgcggaggatatcactaaagatggccgtattgttcaggcgatcaaccaagtggttagcagt

SEQ ID NO: 2290 - protein, 562 aa, Artificial Sequence
  Variant of Tyrosine Ammonia Lyase from Stanieria cyanosphaera
MIIASQTDTFDSKSPHQASDSTVTVGDKPLTINEVSAVARYGAKVRLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEDPIQDRYSMRCLPQYTGPIVDGIAEIANQIEVEINSVTDNPLIDVAGNASYHGGNFMGQYIGTSMDRLRYYLGLLAKHLDAQIALLTMPEFNNGLPASLVGNTDRMVNMGLKGLQITGNSIMPLLTFLGNTLGDRFPTHAEQFNQNINSQGFGSANLTRQSIEIFQQYIAIALMFGVQSVDLRTKKIANHYDASQCLSPATRQLYLAVKEVVGKTPSKDRPYIWNDNEQALDEHIALIAEDITKDGRIVQAINQVVSS
